United States Patent 12,569,549 (FLAVIVIRUS VACCINE) - sequence listing, part 47

SEQ ID NO: 17147 - RNA, 9876 nt, synthetic construct
  misc_feature 1..9876: note = derived and/or modified CDS sequence (opt4) from DENV-2__FJ906961__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggaggtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17148 - RNA, 9876 nt, synthetic construct
  misc_feature 1..9876: note = derived and/or modified CDS sequence (opt4) from DENV-2__FJ906962__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgagatcaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaacatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatcgaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17149 - RNA, 9876 nt, synthetic construct
  misc_feature 1..9876: note = derived and/or modified CDS sequence (opt4) from DENV-2__FJ850053__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17150 - RNA, 9876 nt, synthetic construct
  misc_feature 1..9876: note = derived and/or modified CDS sequence (opt4) from DENV-2__JN819420__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagagagccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacagcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatgggctgctacagccagttcaagcccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17151 - RNA, 9876 nt, synthetic construct
  misc_feature 1..9876: note = derived and/or modified CDS sequence (opt4) from DENV-2__FJ850118__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggctacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17152 - RNA, 9876 nt, synthetic construct
  misc_feature 1..9876: note = derived and/or modified CDS sequence (opt4) from DENV-2__JN819416__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17153 - RNA, 9876 nt, synthetic construct
  misc_feature 1..9876: note = derived and/or modified CDS sequence (opt4) from DENV-2__FJ850119__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcatcaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccagcgaggagaccgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17154 - RNA, 9876 nt, synthetic construct
  misc_feature 1..9876: note = derived and/or modified CDS sequence (opt4) from DENV-2__FJ850064__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17155 - RNA, 9876 nt, synthetic construct
  misc_feature 1..9876: note = derived and/or modified CDS sequence (opt4) from DENV-2__FJ850065__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcaccgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggaggacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagcacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17156 - RNA, 9876 nt, synthetic construct
  misc_feature 1..9876: note = derived and/or modified CDS sequence (opt4) from DENV-2__FJ873808__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcgccatcctggccgccgtgagcgtgagccccctgctgctgaccagcagcaagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcagaaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcaagctgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccagggcaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17157 - RNA, 9876 nt, synthetic construct
  misc_feature 1..9876: note = derived and/or modified CDS sequence (opt4) from DENV-2__FJ850120__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcgtgaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccaagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcagcatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17158 - RNA, 9876 nt, synthetic construct
  misc_feature 1..9876: note = derived and/or modified CDS sequence (opt4) from DENV-2__FJ850121__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgtgaccctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17159 - RNA, 9876 nt, synthetic construct
  misc_feature 1..9876: note = derived and/or modified CDS sequence (opt4) from DENV-2__GQ199897__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtggtgagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17160 - RNA, 9876 nt, synthetic construct
  misc_feature 1..9876: note = derived and/or modified CDS sequence (opt4) from DENV-2__GQ199895__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggaggacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17161 - RNA, 9876 nt, synthetic construct
  misc_feature 1..9876: note = derived and/or modified CDS sequence (opt4) from DENV-2__FJ898478__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17162 - RNA, 9876 nt, synthetic construct
  misc_feature 1..9876: note = derived and/or modified CDS sequence (opt4) from DENV-2__GQ199869__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17163 - RNA, 9876 nt, synthetic construct
  misc_feature 1..9876: note = derived and/or modified CDS sequence (opt4) from DENV-2__JX079688__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcatcgaggagtacaccgactacatgcccagcatgaagagattcagaagagaggaggaggaggccggcgtgctgtggtga

SEQ ID NO: 17164 - RNA, 9876 nt, synthetic construct
  misc_feature 1..9876: note = derived and/or modified CDS sequence (opt4) from DENV-2__JF357906__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccgtgctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcatcttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcagaaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggtacatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17165 - RNA, 9873 nt, synthetic construct
  misc_feature 1..9873: note = derived and/or modified CDS sequence (opt4) from DENV-2__HQ705624__SS-prME
  source 1..9873: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccaagttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaaggtgcccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatcaagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagacaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgctgctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17166 - RNA, 9876 nt, synthetic construct
  misc_feature 1..9876: note = derived and/or modified CDS sequence (opt4) from DENV-2__HQ705625__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatgaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcaccaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17167 - RNA, 9876 nt, synthetic construct
  misc_feature 1..9876: note = derived and/or modified CDS sequence (opt4) from DENV-2__JF730052__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatgaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgaccaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcaccaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17168 - RNA, 9876 nt, synthetic construct
  misc_feature 1..9876: note = derived and/or modified CDS sequence (opt4) from DENV-2__EU482748__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggagaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaagaccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17169 - RNA, 9876 nt, synthetic construct
  misc_feature 1..9876: note = derived and/or modified CDS sequence (opt4) from DENV-2__EU482749__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagaccatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgagcgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17170 - RNA, 9876 nt, synthetic construct
  misc_feature 1..9876: note = derived and/or modified CDS sequence (opt4) from DENV-2__EU482751__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17171 - RNA, 9876 nt, synthetic construct
  misc_feature 1..9876: note = derived and/or modified CDS sequence (opt4) from DENV-2__GQ868604__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggcagaggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaacatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17172 - RNA, 9876 nt, synthetic construct
  misc_feature 1..9876: note = derived and/or modified CDS sequence (opt4) from DENV-2__EU482752__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaacatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17173 - RNA, 9876 nt, synthetic construct
  misc_feature 1..9876: note = derived and/or modified CDS sequence (opt4) from DENV-2__EU482753__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcatgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17174 - RNA, 9876 nt, synthetic construct
  misc_feature 1..9876: note = derived and/or modified CDS sequence (opt4) from DENV-2__EU482680__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcaccggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagaagcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17175 - RNA, 9876 nt, synthetic construct
  misc_feature 1..9876: note = derived and/or modified CDS sequence (opt4) from DENV-2__EU482754__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacatccacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17176 - RNA, 9876 nt, synthetic construct
  misc_feature 1..9876: note = derived and/or modified CDS sequence (opt4) from DENV-2__FJ478455__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgtggagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17177 - RNA, 9876 nt, synthetic construct
  misc_feature 1..9876: note = derived and/or modified CDS sequence (opt4) from DENV-2__EU482756__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagtacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17178 - RNA, 9876 nt, synthetic construct
  misc_feature 1..9876: note = derived and/or modified CDS sequence (opt4) from DENV-2__EU482757__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17179 - RNA, 9876 nt, synthetic construct
  misc_feature 1..9876: note = derived and/or modified CDS sequence (opt4) from DENV-2__FJ906956__SS-prME
  source 1..9876: mol_type = other RNA
accgccggcgtgatcgtgatgctgatccccaccgccatggccttccacctgaccaccagaaacggcgagccccacatgatcgtgggcaagcaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagagagtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaaccacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17180 - RNA, 9876 nt, synthetic construct
  misc_feature 1..9876: note = derived and/or modified CDS sequence (opt4) from DENV-2__EU482759__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagaggcgccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17181 - RNA, 9876 nt, synthetic construct
  misc_feature 1..9876: note = derived and/or modified CDS sequence (opt4) from DENV-2__EU482760__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcgccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17182 - RNA, 9876 nt, synthetic construct
  misc_feature 1..9876: note = derived and/or modified CDS sequence (opt4) from DENV-2__EU482762__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17183 - RNA, 9876 nt, synthetic construct
  misc_feature 1..9876: note = derived and/or modified CDS sequence (opt4) from DENV-2__EU482763__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17184 - RNA, 9876 nt, synthetic construct
  misc_feature 1..9876: note = derived and/or modified CDS sequence (opt4) from DENV-2__EU482444__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccatccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgtgatgtacgccgacgacaccgccggctgggacaccagaatcaccctggaggacctgaagaacgaggagctggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17185 - RNA, 9876 nt, synthetic construct
  misc_feature 1..9876: note = derived and/or modified CDS sequence (opt4) from DENV-2__EU482684__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccaccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17186 - RNA, 9876 nt, synthetic construct
  misc_feature 1..9876: note = derived and/or modified CDS sequence (opt4) from DENV-2__EU482685__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggcaacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagacaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17187 - RNA, 9876 nt, synthetic construct
  misc_feature 1..9876: note = derived and/or modified CDS sequence (opt4) from DENV-2__EU482687__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccgtgctggcctacaccatcggcaccacccacttccagagagccctgatcttcgtgctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatgaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17188 - RNA, 9876 nt, synthetic construct
  misc_feature 1..9876: note = derived and/or modified CDS sequence (opt4) from DENV-2__EU482688__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcctggtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcatgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17189 - RNA, 9876 nt, synthetic construct
  misc_feature 1..9876: note = derived and/or modified CDS sequence (opt4) from DENV-2__EU482691__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacatcaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17190 - RNA, 9876 nt, synthetic construct
  misc_feature 1..9876: note = derived and/or modified CDS sequence (opt4) from DENV-2__EU482693__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccaccctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccgccgaggagaacgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17191 - RNA, 9876 nt, synthetic construct
  misc_feature 1..9876: note = derived and/or modified CDS sequence (opt4) from DENV-2__EU596483__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatggagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggagaccggcgtgctgtggtga

SEQ ID NO: 17192 - RNA, 9876 nt, synthetic construct
  misc_feature 1..9876: note = derived and/or modified CDS sequence (opt4) from DENV-2__EU482597__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgagcgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17193 - RNA, 9876 nt, synthetic construct
  misc_feature 1..9876: note = derived and/or modified CDS sequence (opt4) from DENV-2__EU482598__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17194 - RNA, 9876 nt, synthetic construct
  misc_feature 1..9876: note = derived and/or modified CDS sequence (opt4) from DENV-2__EU482603__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgccgagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagagacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaagaccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17195 - RNA, 9876 nt, synthetic construct
  misc_feature 1..9876: note = derived and/or modified CDS sequence (opt4) from DENV-2__EU482599__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggtgatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17196 - RNA, 9876 nt, synthetic construct
  misc_feature 1..9876: note = derived and/or modified CDS sequence (opt4) from DENV-2__FJ898436__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgcctggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17197 - RNA, 9876 nt, synthetic construct
  misc_feature 1..9876: note = derived and/or modified CDS sequence (opt4) from DENV-2__EU482634__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacaccaagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17198 - RNA, 9876 nt, synthetic construct
  misc_feature 1..9876: note = derived and/or modified CDS sequence (opt4) from DENV-2__EU482635__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgagcgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17199 - RNA, 9876 nt, synthetic construct
  misc_feature 1..9876: note = derived and/or modified CDS sequence (opt4) from DENV-2__GQ199874__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17200 - RNA, 9876 nt, synthetic construct
  misc_feature 1..9876: note = derived and/or modified CDS sequence (opt4) from DENV-2__EU482639__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccctggtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgagaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17201 - RNA, 9876 nt, synthetic construct
  misc_feature 1..9876: note = derived and/or modified CDS sequence (opt4) from DENV-2__EU482766__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagcagcagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17202 - RNA, 9876 nt, synthetic construct
  misc_feature 1..9876: note = derived and/or modified CDS sequence (opt4) from DENV-2__EU482695__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17203 - RNA, 9876 nt, synthetic construct
  misc_feature 1..9876: note = derived and/or modified CDS sequence (opt4) from DENV-2__EU482769__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcatgatcggcctgaccagcagagccacctgggccaagaacatccagaccgccatcaaccaggtgagaagcctgatcggcaacgaggagtacatcgactacatgcccagcatgaagagattcagaagagaggaggaggaggccggcgtgctgtggtga

SEQ ID NO: 17204 - RNA, 9876 nt, synthetic construct
  misc_feature 1..9876: note = derived and/or modified CDS sequence (opt4) from DENV-2__EU482696__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggccagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccaccctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcaccttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcatcgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccgccgaggagatcgtggtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17205 - RNA, 9876 nt, synthetic construct
  misc_feature 1..9876: note = derived and/or modified CDS sequence (opt4) from DENV-2__KC294207__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctactgcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggccccggccacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17206 - RNA, 9876 nt, synthetic construct
  misc_feature 1..9876: note = derived and/or modified CDS sequence (opt4) from DENV-2__KC294208__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcgaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17207 - RNA, 9876 nt, synthetic construct
  misc_feature 1..9876: note = derived and/or modified CDS sequence (opt4) from DENV-2__KC294209__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17208 - RNA, 9876 nt, synthetic construct
  misc_feature 1..9876: note = derived and/or modified CDS sequence (opt4) from DENV-2__KC294214__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggagaaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccaccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17209 - RNA, 9876 nt, synthetic construct
  misc_feature 1..9876: note = derived and/or modified CDS sequence (opt4) from DENV-2__KC294205__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccaccagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaccaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17210 - RNA, 9876 nt, synthetic construct
  misc_feature 1..9876: note = derived and/or modified CDS sequence (opt4) from DENV-2__KC294210__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgatgatggagagcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggtgagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17211 - RNA, 9876 nt, synthetic construct
  misc_feature 1..9876: note = derived and/or modified CDS sequence (opt4) from DENV-2__KC294215__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17212 - RNA, 9876 nt, synthetic construct
  misc_feature 1..9876: note = derived and/or modified CDS sequence (opt4) from DENV-2__KC294216__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcctgaccctgatcaccggcaacatgagcttcagagacctgggcagagtgatggtgatggtgggcgtggccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccacccccgagaccatcctggagctgaccgacgccctggccctgggcatgatggtgctgaagatcgtgagaaacatggagaagtaccagctggccgtgaccatcatgaccatcagctgcgtgcccaacgccatgatcctgatcaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgagaaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagagagacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggccatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccgtgttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17213 - RNA, 9876 nt, synthetic construct
  misc_feature 1..9876: note = derived and/or modified CDS sequence (opt4) from DENV-2__KC294218__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcctgatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17214 - RNA, 9876 nt, synthetic construct
  misc_feature 1..9876: note = derived and/or modified CDS sequence (opt4) from DENV-2__KC294220__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagatgtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17215 - RNA, 9876 nt, synthetic construct
  misc_feature 1..9876: note = derived and/or modified CDS sequence (opt4) from DENV-2__KC294221__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagagaggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17216 - RNA, 9876 nt, synthetic construct
  misc_feature 1..9876: note = derived and/or modified CDS sequence (opt4) from DENV-2__KC294223__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggtggtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17217 - RNA, 9876 nt, synthetic construct
  misc_feature 1..9876: note = derived and/or modified CDS sequence (opt4) from DENV-2__FJ906959__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgatcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggatcatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgcagccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17218 - RNA, 9876 nt, synthetic construct
  misc_feature 1..9876: note = derived and/or modified CDS sequence (opt4) from DENV-2__KF360005__SS-prME
  source 1..9876: mol_type = other RNA
accgccggcgtgatcatcatgagaatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtgggcagaggctggggcgacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccctgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagaatccagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgaggtgagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgagcgccgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggcagaaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcgccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgccgacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcagccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgagaggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcgtggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccgtgtggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaagcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagaggcctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagaggcgaccagtggtgcggcagcctgatcggcctgaccagcagagccacctgggccagaaacatccagaccgccatcaacagagtgagaagcctgatcggcagcgagggctacaccgactacatgcccagcatgaagagattcagaagagaggaggacgaggccggcgtgctgtggtga

SEQ ID NO: 17219 - RNA, 9876 nt, synthetic construct
  misc_feature 1..9876: note = derived and/or modified CDS sequence (opt4) from DENV-2__KJ010185__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacgccaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaaccccctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagaatccagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcttcaccgacaacgtgcacacctggaccgagcagtacaagttccagcccgagagccccagcaagctggccagcgccatccagaaggcccacgaggagggcatctgcggcatcagaagcatcaccagactggacaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgcccagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccagcagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagagtgagcctgctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgctgaccggcgccgacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgaccccgacgtggacctgggcagcggcaccagaaacatcggcatcgagagcgagacccccaacctggacatcatcggcaagagaatcgagaagatcaagcaggagcacgagaccagcagacactacgaccaggaccacccctacaagacctgggcctaccacggcagctacgagaccaagcagaccggcagcgccagcagcaccgtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcgtgcaggtgggcacctacggcctgggcaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccggccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcggcagagaggaggaggaggccggcgtgctgtggtga

SEQ ID NO: 17220 - RNA, 9876 nt, synthetic construct
  misc_feature 1..9876: note = derived and/or modified CDS sequence (opt4) from DENV-2__KJ010186__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacgccaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccagactgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaagccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaccgccctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcctgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgagaagctacccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17221 - RNA, 9876 nt, synthetic construct
  misc_feature 1..9876: note = derived and/or modified CDS sequence (opt4) from DENV-2__KF955364__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacggcgtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgctgtgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagtacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17222 - RNA, 9876 nt, synthetic construct
  misc_feature 1..9876: note = derived and/or modified CDS sequence (opt4) from DENV-2__KF955372__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagtacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacgtggaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcaccgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17223 - RNA, 9876 nt, synthetic construct
  misc_feature 1..9876: note = derived and/or modified CDS sequence (opt4) from DENV-2__KF955373__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccctgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17224 - RNA, 9876 nt, synthetic construct
  misc_feature 1..9876: note = derived and/or modified CDS sequence (opt4) from DENV-2__GQ868600__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacttcgccggccccgtgagccagcacaacaacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccagcgaggagatcgccgtgcaggactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacaaggtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17225 - RNA, 9876 nt, synthetic construct
  misc_feature 1..9876: note = derived and/or modified CDS sequence (opt4) from DENV-2__KF955359__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccatcctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgccagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17226 - RNA, 9876 nt, synthetic construct
  misc_feature 1..9876: note = derived and/or modified CDS sequence (opt4) from DENV-2__KF955360__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcgccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17227 - RNA, 9876 nt, synthetic construct
  misc_feature 1..9876: note = derived and/or modified CDS sequence (opt4) from DENV-2__KF955363__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcaggtgacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggtgatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17228 - RNA, 9876 nt, synthetic construct
  misc_feature 1..9876: note = derived and/or modified CDS sequence (opt4) from DENV-2__EU726767__SS-prME
  source 1..9876: mol_type = other RNA
agcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcgccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacgtgaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcatgaccctgatcaccggcaacatgagcttcaaggacctgggcagagtggtggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgccctgctgagccagagcaccatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgtgacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccgtgttcaccgacgagaacaagtggaagagcgccagagaggccgtggaggacagcagattctgggagctggtggacaaggagagaagcctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17229 - RNA, 9876 nt, synthetic construct
  misc_feature 1..9876: note = derived and/or modified CDS sequence (opt4) from DENV-2__EU687246__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccctgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaacatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcagcgaggagtacaccgactacatgcccagcatgaagagattcagaagagaggaggaggaggccggcgtgctgtggtga

SEQ ID NO: 17230 - RNA, 9876 nt, synthetic construct
  misc_feature 1..9876: note = derived and/or modified CDS sequence (opt4) from DENV-2__FJ639828__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgccaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgttcctgagaaagctgaccagcaaggagctgatgatgaccaccatcggcatcgtgctgctgagccagagcaccctgcccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgacccacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17231 - RNA, 9876 nt, synthetic construct
  misc_feature 1..9876: note = derived and/or modified CDS sequence (opt4) from DENV-2__FJ639829__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgttcctgagaaagctgaccagcaaggagctgatgatgaccaccatcggcatcgtgctgctgagccagagcaccatccccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgacccacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17232 - RNA, 9876 nt, synthetic construct
  misc_feature 1..9876: note = derived and/or modified CDS sequence (opt4) from DENV-2__FJ639831__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatcgtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcgtgaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgtggccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcgtgctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccatgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaagaccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaagctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatctacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17233 - RNA, 9876 nt, synthetic construct
  misc_feature 1..9876: note = derived and/or modified CDS sequence (opt4) from DENV-2__FJ639832__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17234 - RNA, 9876 nt, synthetic construct
  misc_feature 1..9876: note = derived and/or modified CDS sequence (opt4) from DENV-2__FJ687434__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccagactgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccagcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggccatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17235 - RNA, 9876 nt, synthetic construct
  misc_feature 1..9876: note = derived and/or modified CDS sequence (opt4) from DENV-2__FJ687439__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgccaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacatcagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17236 - RNA, 9876 nt, synthetic construct
  misc_feature 1..9876: note = derived and/or modified CDS sequence (opt4) from DENV-2__FJ687440__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctggatcacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaccggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17237 - RNA, 9876 nt, synthetic construct
  misc_feature 1..9876: note = derived and/or modified CDS sequence (opt4) from DENV-2__FJ687441__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctggatcacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17238 - RNA, 9876 nt, synthetic construct
  misc_feature 1..9876: note = derived and/or modified CDS sequence (opt4) from DENV-2__FJ687445__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgttcctgagaaagctgaccagcaaggagctgatgatgaccaccatcggcatcgtgctgctgagccagagcaccatccccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgacccacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccccacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17239 - RNA, 9876 nt, synthetic construct
  misc_feature 1..9876: note = derived and/or modified CDS sequence (opt4) from DENV-2__FJ687447__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccagcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatcggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggccttcaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17240 - RNA, 9876 nt, synthetic construct
  misc_feature 1..9876: note = derived and/or modified CDS sequence (opt4) from DENV-2__FJ810411__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccagcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatcggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggccttcaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17241 - RNA, 9876 nt, synthetic construct
  misc_feature 1..9876: note = derived and/or modified CDS sequence (opt4) from DENV-2__FJ744713__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccagcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatcggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggccttcaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17242 - RNA, 9876 nt, synthetic construct
  misc_feature 1..9876: note = derived and/or modified CDS sequence (opt4) from DENV-2__FJ744714__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagagaatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17243 - RNA, 9876 nt, synthetic construct
  misc_feature 1..9876: note = derived and/or modified CDS sequence (opt4) from DENV-2__FJ744716__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagagaatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgagaaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17244 - RNA, 9876 nt, synthetic construct
  misc_feature 1..9876: note = derived and/or modified CDS sequence (opt4) from DENV-2__FJ744718__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcagccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17245 - RNA, 9876 nt, synthetic construct
  misc_feature 1..9876: note = derived and/or modified CDS sequence (opt4) from DENV-2__FJ744722__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccaacctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgttcctgagaaagctgaccagcaaggagctgatgatgaccaccatcggcatcgtgctgctgagccagagcaccatccccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgacccacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17246 - RNA, 9876 nt, synthetic construct
  misc_feature 1..9876: note = derived and/or modified CDS sequence (opt4) from DENV-2__FJ744723__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagaaccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgttcctgagaaagctgaccagcaaggagctgatgatgaccaccatcggcatcgtgctgctgagccagagcaccatccccgagaccatcctggagctgaccgacgccctggccctgggcatgatggtgctgaagatggtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgacccacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacagcagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagaccgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17247 - RNA, 9876 nt, synthetic construct
  misc_feature 1..9876: note = derived and/or modified CDS sequence (opt4) from DENV-2__FJ744724__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatcgtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcgtgaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17248 - RNA, 9876 nt, synthetic construct
  misc_feature 1..9876: note = derived and/or modified CDS sequence (opt4) from DENV-2__FJ906957__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgccagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17249 - RNA, 9876 nt, synthetic construct
  misc_feature 1..9876: note = derived and/or modified CDS sequence (opt4) from DENV-2__FJ906958__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaaggtgcccttcgagatcatggacctggagaagagatacgtgctgggcagactgatcaccgtgaaccccgtggtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccgtgaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccagggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgccaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17250 - RNA, 9876 nt, synthetic construct
  misc_feature 1..9876: note = derived and/or modified CDS sequence (opt4) from DENV-2__FJ898452__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17251 - RNA, 9876 nt, synthetic construct
  misc_feature 1..9876: note = derived and/or modified CDS sequence (opt4) from DENV-2__GQ868591__SS-prME
  source 1..9876: mol_type = other RNA
agcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcaccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagatacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcgccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccatcaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17252 - RNA, 9876 nt, synthetic construct
  misc_feature 1..9876: note = derived and/or modified CDS sequence (opt4) from DENV-2__GQ868542__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcggcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcaccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggacagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17253 - RNA, 9876 nt, synthetic construct
  misc_feature 1..9876: note = derived and/or modified CDS sequence (opt4) from DENV-2__GQ868544__SS-prME
  source 1..9876: mol_type = other RNA
agcgtgggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaaggtgcccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccagggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgtacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17254 - RNA, 9876 nt, synthetic construct
  misc_feature 1..9876: note = derived and/or modified CDS sequence (opt4) from DENV-2__GQ868545__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatcgtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcgtgaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccctggccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccaccctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgacatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaagctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17255 - RNA, 9876 nt, synthetic construct
  misc_feature 1..9876: note = derived and/or modified CDS sequence (opt4) from DENV-2__GQ868543__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcatgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggtgaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17256 - RNA, 9876 nt, synthetic construct
  misc_feature 1..9876: note = derived and/or modified CDS sequence (opt4) from DENV-2__EU482544__SS-prME
  source 1..9876: mol_type = other RNA
accgccggcgtgatcatcatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17257 - RNA, 9876 nt, synthetic construct
  misc_feature 1..9876: note = derived and/or modified CDS sequence (opt4) from DENV-2__EU482545__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcatgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcagaaacgaggaggaggagcagaccctgaccatcctgatcagaaccggcctgctggtgatcagcggcgtgttccccgtgagcatccccgtgaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17258 - RNA, 9876 nt, synthetic construct
  misc_feature 1..9876: note = derived and/or modified CDS sequence (opt4) from DENV-2__EU482546__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcatcaacatgtgcaccctgatggccatcgacctgggcgagctgtgcgaggacaccatcacctacaagtgccccctgctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaaccacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcttcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagagtgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcagccaggtgagaagcctgatcggcaacgaggagtacaccgactacatgcccagcatgaagagattcagaagagaggaggaggaggccggcgtgctgtggtga

SEQ ID NO: 17259 - RNA, 9876 nt, synthetic construct
  misc_feature 1..9876: note = derived and/or modified CDS sequence (opt4) from DENV-2__EU482550__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaagccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagaccctggtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17260 - RNA, 9876 nt, synthetic construct
  misc_feature 1..9876: note = derived and/or modified CDS sequence (opt4) from DENV-2__EU482551__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17261 - RNA, 9876 nt, synthetic construct
  misc_feature 1..9876: note = derived and/or modified CDS sequence (opt4) from DENV-2__EU482552__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcaccggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggctacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17262 - RNA, 9876 nt, synthetic construct
  misc_feature 1..9876: note = derived and/or modified CDS sequence (opt4) from DENV-2__EU482554__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaccgtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaagccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagaccctggtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17263 - RNA, 9876 nt, synthetic construct
  misc_feature 1..9876: note = derived and/or modified CDS sequence (opt4) from DENV-2__EU482556__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggtgagccacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccgtgctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccctgatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggtgagagtgggcagagagagactgagcagaatggccgtgagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17264 - RNA, 9876 nt, synthetic construct
  misc_feature 1..9876: note = derived and/or modified CDS sequence (opt4) from DENV-2__EU529693__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17265 - RNA, 9876 nt, synthetic construct
  misc_feature 1..9876: note = derived and/or modified CDS sequence (opt4) from DENV-2__EU482557__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17266 - RNA, 9876 nt, synthetic construct
  misc_feature 1..9876: note = derived and/or modified CDS sequence (opt4) from DENV-2__EU482560__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcatcaacatgtgcaccctgatggccatcgacctgggcgagctgtgcgaggacaccatcacctacaagtgccccctgctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaaccacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcctggtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcttcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgagaacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagagtgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcagccaggtgagaagcctgatcggcaacgaggagtacaccgactacatgcccagcatgaagagattcagaagagaggaggaggaggccggcgtgctgtggtga

SEQ ID NO: 17267 - RNA, 9876 nt, synthetic construct
  misc_feature 1..9876: note = derived and/or modified CDS sequence (opt4) from DENV-2__EU482561__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggtggtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17268 - RNA, 9876 nt, synthetic construct
  misc_feature 1..9876: note = derived and/or modified CDS sequence (opt4) from DENV-2__EU569703__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17269 - RNA, 9876 nt, synthetic construct
  misc_feature 1..9876: note = derived and/or modified CDS sequence (opt4) from DENV-2__EU529694__SS-prME
  source 1..9876: mol_type = other RNA
accgccggcgtgttcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17270 - RNA, 9876 nt, synthetic construct
  misc_feature 1..9876: note = derived and/or modified CDS sequence (opt4) from DENV-2__EU529695__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17271 - RNA, 9876 nt, synthetic construct
  misc_feature 1..9876: note = derived and/or modified CDS sequence (opt4) from DENV-2__EU482562__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgatcctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcttcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17272 - RNA, 9876 nt, synthetic construct
  misc_feature 1..9876: note = derived and/or modified CDS sequence (opt4) from DENV-2__EU482565__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagcccccccaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacgtgggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17273 - RNA, 9876 nt, synthetic construct
  misc_feature 1..9876: note = derived and/or modified CDS sequence (opt4) from DENV-2__EU529700__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacctggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17274 - RNA, 9876 nt, synthetic construct
  misc_feature 1..9876: note = derived and/or modified CDS sequence (opt4) from DENV-2__EU529701__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcttcatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17275 - RNA, 9876 nt, synthetic construct
  misc_feature 1..9876: note = derived and/or modified CDS sequence (opt4) from DENV-2__EU569704__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17276 - RNA, 9876 nt, synthetic construct
  misc_feature 1..9876: note = derived and/or modified CDS sequence (opt4) from DENV-2__EU482568__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagagtggagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtgggccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17277 - RNA, 9876 nt, synthetic construct
  misc_feature 1..9876: note = derived and/or modified CDS sequence (opt4) from DENV-2__EU482569__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgatccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17278 - RNA, 9876 nt, synthetic construct
  misc_feature 1..9876: note = derived and/or modified CDS sequence (opt4) from DENV-2__EU482570__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcaggtgacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgggctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgaaggacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggtgatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17279 - RNA, 9876 nt, synthetic construct
  misc_feature 1..9876: note = derived and/or modified CDS sequence (opt4) from DENV-2__EU482571__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgcctggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17280 - RNA, 9876 nt, synthetic construct
  misc_feature 1..9876: note = derived and/or modified CDS sequence (opt4) from DENV-2__EU482572__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcaggtgacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccggcgactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgatgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgaggccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggtgatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17281 - RNA, 9876 nt, synthetic construct
  misc_feature 1..9876: note = derived and/or modified CDS sequence (opt4) from DENV-2__EU482573__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17282 - RNA, 9876 nt, synthetic construct
  misc_feature 1..9876: note = derived and/or modified CDS sequence (opt4) from DENV-2__EU482574__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcacatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17283 - RNA, 9876 nt, synthetic construct
  misc_feature 1..9876: note = derived and/or modified CDS sequence (opt4) from DENV-2__EU482575__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagagaagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17284 - RNA, 9876 nt, synthetic construct
  misc_feature 1..9876: note = derived and/or modified CDS sequence (opt4) from DENV-2__EU482578__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17285 - RNA, 9876 nt, synthetic construct
  misc_feature 1..9876: note = derived and/or modified CDS sequence (opt4) from DENV-2__EU482580__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcttcatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17286 - RNA, 9876 nt, synthetic construct
  misc_feature 1..9876: note = derived and/or modified CDS sequence (opt4) from DENV-2__EU482581__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17287 - RNA, 9876 nt, synthetic construct
  misc_feature 1..9876: note = derived and/or modified CDS sequence (opt4) from DENV-2__EU482582__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccaaccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgtgttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcaccaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcaccgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17288 - RNA, 9876 nt, synthetic construct
  misc_feature 1..9876: note = derived and/or modified CDS sequence (opt4) from DENV-2__EU482583__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacgccgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17289 - RNA, 9876 nt, synthetic construct
  misc_feature 1..9876: note = derived and/or modified CDS sequence (opt4) from DENV-2__EU482585__SS-prME
  source 1..9876: mol_type = other RNA
accgccggcgtgatcatcatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcggcatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacagcaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17290 - RNA, 9876 nt, synthetic construct
  misc_feature 1..9876: note = derived and/or modified CDS sequence (opt4) from DENV-2__EU482587__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggtggagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcagagagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaacagaaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagatcgtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17291 - RNA, 9876 nt, synthetic construct
  misc_feature 1..9876: note = derived and/or modified CDS sequence (opt4) from DENV-2__EU482588__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaaggtgcccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17292 - RNA, 9876 nt, synthetic construct
  misc_feature 1..9876: note = derived and/or modified CDS sequence (opt4) from DENV-2__EU569705__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcgtgatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17293 - RNA, 9876 nt, synthetic construct
  misc_feature 1..9876: note = derived and/or modified CDS sequence (opt4) from DENV-2__EU482589__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaatgggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctggtgaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17294 - RNA, 9876 nt, synthetic construct
  misc_feature 1..9876: note = derived and/or modified CDS sequence (opt4) from DENV-2__EU569706__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacctggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17295 - RNA, 9876 nt, synthetic construct
  misc_feature 1..9876: note = derived and/or modified CDS sequence (opt4) from DENV-2__EU569707__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgagaatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17296 - RNA, 9876 nt, synthetic construct
  misc_feature 1..9876: note = derived and/or modified CDS sequence (opt4) from DENV-2__EU660399__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagacagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17297 - RNA, 9876 nt, synthetic construct
  misc_feature 1..9876: note = derived and/or modified CDS sequence (opt4) from DENV-2__EU569708__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatcaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcgtgaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagagaatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccgtgttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaagaaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17298 - RNA, 9876 nt, synthetic construct
  misc_feature 1..9876: note = derived and/or modified CDS sequence (opt4) from DENV-2__EU569709__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17299 - RNA, 9876 nt, synthetic construct
  misc_feature 1..9876: note = derived and/or modified CDS sequence (opt4) from DENV-2__EU596485__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgacagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17300 - RNA, 9876 nt, synthetic construct
  misc_feature 1..9876: note = derived and/or modified CDS sequence (opt4) from DENV-2__EU569710__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgaccttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccatcctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17301 - RNA, 9876 nt, synthetic construct
  misc_feature 1..9876: note = derived and/or modified CDS sequence (opt4) from DENV-2__EU596486__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaagccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacatcgactacatgcccagcatgaagagattcagaaaggaggaggaggaggccggcgtgctgtggtga

SEQ ID NO: 17302 - RNA, 9876 nt, synthetic construct
  misc_feature 1..9876: note = derived and/or modified CDS sequence (opt4) from DENV-2__EU687212__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcatcaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccgtgcccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17303 - RNA, 9876 nt, synthetic construct
  misc_feature 1..9876: note = derived and/or modified CDS sequence (opt4) from DENV-2__EU660400__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccaccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagcagacagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17304 - RNA, 9876 nt, synthetic construct
  misc_feature 1..9876: note = derived and/or modified CDS sequence (opt4) from DENV-2__EU569711__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17305 - RNA, 9876 nt, synthetic construct
  misc_feature 1..9876: note = derived and/or modified CDS sequence (opt4) from DENV-2__EU569712__SS-prME
  source 1..9876: mol_type = other RNA
accgccggcatgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgagaaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17306 - RNA, 9876 nt, synthetic construct
  misc_feature 1..9876: note = derived and/or modified CDS sequence (opt4) from DENV-2__EU596487__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17307 - RNA, 9876 nt, synthetic construct
  misc_feature 1..9876: note = derived and/or modified CDS sequence (opt4) from DENV-2__EU569713__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcagcgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggccaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttctacaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggagaaggccggcgtgctgtggtga

SEQ ID NO: 17308 - RNA, 9876 nt, synthetic construct
  misc_feature 1..9876: note = derived and/or modified CDS sequence (opt4) from DENV-2__EU569714__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgtgatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17309 - RNA, 9876 nt, synthetic construct
  misc_feature 1..9876: note = derived and/or modified CDS sequence (opt4) from DENV-2__EU569715__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccggcggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17310 - RNA, 9876 nt, synthetic construct
  misc_feature 1..9876: note = derived and/or modified CDS sequence (opt4) from DENV-2__EU569716__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcatctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaagccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17311 - RNA, 9876 nt, synthetic construct
  misc_feature 1..9876: note = derived and/or modified CDS sequence (opt4) from DENV-2__EU569717__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctggtgaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17312 - RNA, 9876 nt, synthetic construct
  misc_feature 1..9876: note = derived and/or modified CDS sequence (opt4) from DENV-2__EU569718__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagtacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacgtggaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17313 - RNA, 9876 nt, synthetic construct
  misc_feature 1..9876: note = derived and/or modified CDS sequence (opt4) from DENV-2__EU596488__SS-prME
  source 1..9876: mol_type = other RNA
accgccggcgtgatcatcatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccatcaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17314 - RNA, 9876 nt, synthetic construct
  misc_feature 1..9876: note = derived and/or modified CDS sequence (opt4) from DENV-2__EU596489__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagttccccagcaagctggccagcgccatcaagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17315 - RNA, 9876 nt, synthetic construct
  misc_feature 1..9876: note = derived and/or modified CDS sequence (opt4) from DENV-2__EU596490__SS-prME
  source 1..9876: mol_type = other RNA
accgccggcgtgatcatcatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacgtgggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17316 - RNA, 9876 nt, synthetic construct
  misc_feature 1..9876: note = derived and/or modified CDS sequence (opt4) from DENV-2__EU596491__SS-prME
  source 1..9876: mol_type = other RNA
accgccggcgtgatcatcatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacgcccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcccacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17317 - RNA, 9876 nt, synthetic construct
  misc_feature 1..9876: note = derived and/or modified CDS sequence (opt4) from DENV-2__EU677141__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17318 - RNA, 9876 nt, synthetic construct
  misc_feature 1..9876: note = derived and/or modified CDS sequence (opt4) from DENV-2__EU677144__SS-prME
  source 1..9876: mol_type = other RNA
accgccggcatgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcctgaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccatggagaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgagaaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17319 - RNA, 9876 nt, synthetic construct
  misc_feature 1..9876: note = derived and/or modified CDS sequence (opt4) from DENV-2__EU677145__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcatcaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccgtgcccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17320 - RNA, 9876 nt, synthetic construct
  misc_feature 1..9876: note = derived and/or modified CDS sequence (opt4) from DENV-2__EU677146__SS-prME
  source 1..9876: mol_type = other RNA
accgtgggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggccaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17321 - RNA, 9876 nt, synthetic construct
  misc_feature 1..9876: note = derived and/or modified CDS sequence (opt4) from DENV-2__EU687214__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccaacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgatcgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17322 - RNA, 9876 nt, synthetic construct
  misc_feature 1..9876: note = derived and/or modified CDS sequence (opt4) from DENV-2__EU687215__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaagaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccgccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17323 - RNA, 9876 nt, synthetic construct
  misc_feature 1..9876: note = derived and/or modified CDS sequence (opt4) from DENV-2__EU687216__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcaacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17324 - RNA, 9876 nt, synthetic construct
  misc_feature 1..9876: note = derived and/or modified CDS sequence (opt4) from DENV-2__EU726770__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcaccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17325 - RNA, 9876 nt, synthetic construct
  misc_feature 1..9876: note = derived and/or modified CDS sequence (opt4) from DENV-2__EU781135__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17326 - RNA, 9876 nt, synthetic construct
  misc_feature 1..9876: note = derived and/or modified CDS sequence (opt4) from DENV-2__EU687222__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17327 - RNA, 9876 nt, synthetic construct
  misc_feature 1..9876: note = derived and/or modified CDS sequence (opt4) from DENV-2__EU687223__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgccttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17328 - RNA, 9876 nt, synthetic construct
  misc_feature 1..9876: note = derived and/or modified CDS sequence (opt4) from DENV-2__EU687227__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccagatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17329 - RNA, 9876 nt, synthetic construct
  misc_feature 1..9876: note = derived and/or modified CDS sequence (opt4) from DENV-2__EU687228__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaacgagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17330 - RNA, 9876 nt, synthetic construct
  misc_feature 1..9876: note = derived and/or modified CDS sequence (opt4) from DENV-2__EU687230__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaggcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17331 - RNA, 9876 nt, synthetic construct
  misc_feature 1..9876: note = derived and/or modified CDS sequence (opt4) from DENV-2__EU687231__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaacatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17332 - RNA, 9876 nt, synthetic construct
  misc_feature 1..9876: note = derived and/or modified CDS sequence (opt4) from DENV-2__EU687199__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatgatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17333 - RNA, 9876 nt, synthetic construct
  misc_feature 1..9876: note = derived and/or modified CDS sequence (opt4) from DENV-2__EU687235__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagcccccccctggtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17334 - RNA, 9876 nt, synthetic construct
  misc_feature 1..9876: note = derived and/or modified CDS sequence (opt4) from DENV-2__EU687236__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17335 - RNA, 9876 nt, synthetic construct
  misc_feature 1..9876: note = derived and/or modified CDS sequence (opt4) from DENV-2__EU687237__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17336 - RNA, 9876 nt, synthetic construct
  misc_feature 1..9876: note = derived and/or modified CDS sequence (opt4) from DENV-2__EU687238__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgaccatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17337 - RNA, 9876 nt, synthetic construct
  misc_feature 1..9876: note = derived and/or modified CDS sequence (opt4) from DENV-2__EU687240__SS-prME
  source 1..9876: mol_type = other RNA
accgtgggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggccaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17338 - RNA, 9876 nt, synthetic construct
  misc_feature 1..9876: note = derived and/or modified CDS sequence (opt4) from DENV-2__EU687241__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacagcatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgaccaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaccatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtggtgacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17339 - RNA, 9876 nt, synthetic construct
  misc_feature 1..9876: note = derived and/or modified CDS sequence (opt4) from DENV-2__EU687242__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgaacgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17340 - RNA, 9876 nt, synthetic construct
  misc_feature 1..9876: note = derived and/or modified CDS sequence (opt4) from DENV-2__EU687243__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgaacgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17341 - RNA, 9876 nt, synthetic construct
  misc_feature 1..9876: note = derived and/or modified CDS sequence (opt4) from DENV-2__EU687245__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgaacgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacgccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccaccagcagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccgtgaaccaggtgagaagcctgatcggcaacgaggagtacaccgactacatgcccagcatgaagagattcagaaaggaggaggaggaggccggcgtgctgtggtga

SEQ ID NO: 17342 - RNA, 9873 nt, synthetic construct
  misc_feature 1..9873: note = derived and/or modified CDS sequence (opt4) from DENV-2__HQ541798__SS-prME
  source 1..9873: mol_type = other RNA
accgccggcatgatcttcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagagcgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaaggacatgaagggcgaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgctggagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagccccacaccctgtggagcaacgaggtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcctgcccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgagcctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccgccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17343 - RNA, 9876 nt, synthetic construct
  misc_feature 1..9876: note = derived and/or modified CDS sequence (opt4) from DENV-2__JF730053__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagagcgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgctggagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacgaggtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcctgcccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgagcctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccgccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17344 - RNA, 9876 nt, synthetic construct
  misc_feature 1..9876: note = derived and/or modified CDS sequence (opt4) from DENV-2__EU529706__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcagaaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17345 - RNA, 9876 nt, synthetic construct
  misc_feature 1..9876: note = derived and/or modified CDS sequence (opt4) from DENV-2__EU482720__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgccaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaacctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17346 - RNA, 9876 nt, synthetic construct
  misc_feature 1..9876: note = derived and/or modified CDS sequence (opt4) from DENV-2__EU482721__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccaccatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17347 - RNA, 9876 nt, synthetic construct
  misc_feature 1..9876: note = derived and/or modified CDS sequence (opt4) from DENV-2__EU482722__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagtggccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagaccctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtgatccccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17348 - RNA, 9876 nt, synthetic construct
  misc_feature 1..9876: note = derived and/or modified CDS sequence (opt4) from DENV-2__EU482723__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagagagcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17349 - RNA, 9876 nt, synthetic construct
  misc_feature 1..9876: note = derived and/or modified CDS sequence (opt4) from DENV-2__EU482724__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccagcagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17350 - RNA, 9876 nt, synthetic construct
  misc_feature 1..9876: note = derived and/or modified CDS sequence (opt4) from DENV-2__EU482725__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacaccggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgagaaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagccagctgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17351 - RNA, 9876 nt, synthetic construct
  misc_feature 1..9876: note = derived and/or modified CDS sequence (opt4) from DENV-2__EU482726__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcatcggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacgcccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17352 - RNA, 9876 nt, synthetic construct
  misc_feature 1..9876: note = derived and/or modified CDS sequence (opt4) from DENV-2__EU482727__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcctactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaagaaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17353 - RNA, 9876 nt, synthetic construct
  misc_feature 1..9876: note = derived and/or modified CDS sequence (opt4) from DENV-2__EU482728__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcctggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17354 - RNA, 9876 nt, synthetic construct
  misc_feature 1..9876: note = derived and/or modified CDS sequence (opt4) from DENV-2__EU482729__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgagatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagatcgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctgatcgccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcctactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaagaaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17355 - RNA, 9876 nt, synthetic construct
  misc_feature 1..9876: note = derived and/or modified CDS sequence (opt4) from DENV-2__EU482731__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacgcccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcccacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17356 - RNA, 9876 nt, synthetic construct
  misc_feature 1..9876: note = derived and/or modified CDS sequence (opt4) from DENV-2__EU482732__SS-prME
  source 1..9876: mol_type = other RNA
accgtgggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgccttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17357 - RNA, 9876 nt, synthetic construct
  misc_feature 1..9876: note = derived and/or modified CDS sequence (opt4) from DENV-2__EU482733__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17358 - RNA, 9876 nt, synthetic construct
  misc_feature 1..9876: note = derived and/or modified CDS sequence (opt4) from DENV-2__EU482734__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcatgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcagaaacgaggaggaggagcagaccctgaccatcctgatcagaaccggcctgctggtgatcagcggcgtgttccccgtgagcatccccgtgaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatcaccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17359 - RNA, 9876 nt, synthetic construct
  misc_feature 1..9876: note = derived and/or modified CDS sequence (opt4) from DENV-2__EU482735__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcatgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcagaaacgaggaggaggagcagaccctgaccatcctgatcagaaccggcctgctggtgatcagcggcgtgttccccgtgagcatccccgtgaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgaccatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17360 - RNA, 9876 nt, synthetic construct
  misc_feature 1..9876: note = derived and/or modified CDS sequence (opt4) from DENV-2__EU482736__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggtggtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgagcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17361 - RNA, 9876 nt, synthetic construct
  misc_feature 1..9876: note = derived and/or modified CDS sequence (opt4) from DENV-2__EU482737__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggtggtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgagcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17362 - RNA, 9876 nt, synthetic construct
  misc_feature 1..9876: note = derived and/or modified CDS sequence (opt4) from DENV-2__EU482739__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacctggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17363 - RNA, 9876 nt, synthetic construct
  misc_feature 1..9876: note = derived and/or modified CDS sequence (opt4) from DENV-2__EU482740__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcagcccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagagagtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17364 - RNA, 9876 nt, synthetic construct
  misc_feature 1..9876: note = derived and/or modified CDS sequence (opt4) from DENV-2__EU482741__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggtggtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17365 - RNA, 9876 nt, synthetic construct
  misc_feature 1..9876: note = derived and/or modified CDS sequence (opt4) from DENV-2__EU482742__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgcccccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17366 - RNA, 9876 nt, synthetic construct
  misc_feature 1..9876: note = derived and/or modified CDS sequence (opt4) from DENV-2__EU482744__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgagcatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17367 - RNA, 9876 nt, synthetic construct
  misc_feature 1..9876: note = derived and/or modified CDS sequence (opt4) from DENV-2__EU482745__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaacagaaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccaccaaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgaagagcctgatcggcaacgaggagtacaccgactacatgcccagcatgaagagattcagaagagaggaggaggaggccggcgtgctgtggtga

SEQ ID NO: 17368 - RNA, 9876 nt, synthetic construct
  misc_feature 1..9876: note = derived and/or modified CDS sequence (opt4) from DENV-2__EU482746__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaacagaaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17369 - RNA, 9876 nt, synthetic construct
  misc_feature 1..9876: note = derived and/or modified CDS sequence (opt4) from DENV-2__EU482590__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccgtgctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcctggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacatcagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17370 - RNA, 9876 nt, synthetic construct
  misc_feature 1..9876: note = derived and/or modified CDS sequence (opt4) from DENV-2__EU482594__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgaagaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgagggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17371 - RNA, 9876 nt, synthetic construct
  misc_feature 1..9876: note = derived and/or modified CDS sequence (opt4) from DENV-2__EU482604__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17372 - RNA, 9876 nt, synthetic construct
  misc_feature 1..9876: note = derived and/or modified CDS sequence (opt4) from DENV-2__EU482605__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctggtgaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggccaaccccgagatcgaggacgccatcttcagaaagaagagactgaccatcatggacctgcaccccggcgccggcaagcccaagagaagcctgcccgccatcgtgagagaggccatcaagagaggcctgagacccctgatcctggccccccccagagtggtgcccgccgagatggaggagcccctgagaggcctgcccatcagataccagacccccgccatcaagcccgaccacaccggcagagagatcgtggccctgatgtgccacgcccccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagagactgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17373 - RNA, 9876 nt, synthetic construct
  misc_feature 1..9876: note = derived and/or modified CDS sequence (opt4) from DENV-2__EU482606__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccaccccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17374 - RNA, 9876 nt, synthetic construct
  misc_feature 1..9876: note = derived and/or modified CDS sequence (opt4) from DENV-2__EU482607__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcgtgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcatcgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccgacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctgaccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17375 - RNA, 9876 nt, synthetic construct
  misc_feature 1..9876: note = derived and/or modified CDS sequence (opt4) from DENV-2__EU482608__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagagactgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagatcaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17376 - RNA, 9876 nt, synthetic construct
  misc_feature 1..9876: note = derived and/or modified CDS sequence (opt4) from DENV-2__EU687220__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccatcaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccacgccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17377 - RNA, 9876 nt, synthetic construct
  misc_feature 1..9876: note = derived and/or modified CDS sequence (opt4) from DENV-2__EU726775__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcagaaccaacaccggcaccatcggcgccatcagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcagaagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17378 - RNA, 9876 nt, synthetic construct
  misc_feature 1..9876: note = derived and/or modified CDS sequence (opt4) from DENV-2__FJ639732__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccgtgaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17379 - RNA, 9876 nt, synthetic construct
  misc_feature 1..9876: note = derived and/or modified CDS sequence (opt4) from DENV-2__FJ639733__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgaggccaccatgagaggcgccaagagaatggccatcctgggcgacaccgcctgggacttcggcagcctgggcggcgccttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaagatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17380 - RNA, 9876 nt, synthetic construct
  misc_feature 1..9876: note = derived and/or modified CDS sequence (opt4) from DENV-2__FJ639734__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagccctggtggtgccctgcagaaaccaggacgagctgatcggcagagccagaaccagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17381 - RNA, 9876 nt, synthetic construct
  misc_feature 1..9876: note = derived and/or modified CDS sequence (opt4) from DENV-2__JN819408__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacatcttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcagaaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagaacaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagggcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17382 - RNA, 9876 nt, synthetic construct
  misc_feature 1..9876: note = derived and/or modified CDS sequence (opt4) from DENV-2__FJ639783__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcgtgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17383 - RNA, 9876 nt, synthetic construct
  misc_feature 1..9876: note = derived and/or modified CDS sequence (opt4) from DENV-2__FJ639788__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccgccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcgtgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaactacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17384 - RNA, 9876 nt, synthetic construct
  misc_feature 1..9876: note = derived and/or modified CDS sequence (opt4) from DENV-2__FJ639822__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcgtgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcatcgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctgaccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17385 - RNA, 9876 nt, synthetic construct
  misc_feature 1..9876: note = derived and/or modified CDS sequence (opt4) from DENV-2__FJ850112__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgccttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaagatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17386 - RNA, 9876 nt, synthetic construct
  misc_feature 1..9876: note = derived and/or modified CDS sequence (opt4) from DENV-2__FJ850105__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgccgagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17387 - RNA, 9876 nt, synthetic construct
  misc_feature 1..9876: note = derived and/or modified CDS sequence (opt4) from DENV-2__FJ850106__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17388 - RNA, 9876 nt, synthetic construct
  misc_feature 1..9876: note = derived and/or modified CDS sequence (opt4) from DENV-2__FJ850107__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgttccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcaagctgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcagacaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17389 - RNA, 9876 nt, synthetic construct
  misc_feature 1..9876: note = derived and/or modified CDS sequence (opt4) from DENV-2__FJ850108__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagatcgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagaatgatggtgatggtgggcgccaccatgaccgacgacatcggcatgggcgtgacctacctggccctgctggccgccttcaaggtgagacccaccttcgtggccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17390 - RNA, 9876 nt, synthetic construct
  misc_feature 1..9876: note = derived and/or modified CDS sequence (opt4) from DENV-2__JN819407__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcctgggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgttcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17391 - RNA, 9876 nt, synthetic construct
  misc_feature 1..9876: note = derived and/or modified CDS sequence (opt4) from DENV-2__FJ898465__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaactaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccacgccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17392 - RNA, 9876 nt, synthetic construct
  misc_feature 1..9876: note = derived and/or modified CDS sequence (opt4) from DENV-2__FJ898466__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagagagcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacatcttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcagaaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagagaaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaagccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17393 - RNA, 9876 nt, synthetic construct
  misc_feature 1..9876: note = derived and/or modified CDS sequence (opt4) from DENV-2__FJ898467__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17394 - RNA, 9876 nt, synthetic construct
  misc_feature 1..9876: note = derived and/or modified CDS sequence (opt4) from DENV-2__GQ868595__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgagaggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatcaagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17395 - RNA, 9876 nt, synthetic construct
  misc_feature 1..9876: note = derived and/or modified CDS sequence (opt4) from DENV-2__GQ868540__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctggtggacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17396 - RNA, 9876 nt, synthetic construct
  misc_feature 1..9876: note = derived and/or modified CDS sequence (opt4) from DENV-2__GQ868541__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccacgccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcaccacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17397 - RNA, 9876 nt, synthetic construct
  misc_feature 1..9876: note = derived and/or modified CDS sequence (opt4) from DENV-2__GQ868603__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgctgtgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggccgccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggtggtgaccatcatggccatcagctgcgtgcccaacgccgtgatcctgcagaacgcctggaaggtgagctgcaccatcctggccgccgtgagcgtgagccccctgctgctgaccagcagcagacagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcttcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagatccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17398 - RNA, 9876 nt, synthetic construct
  misc_feature 1..9876: note = derived and/or modified CDS sequence (opt4) from DENV-2__FJ898450__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacagaacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17399 - RNA, 9876 nt, synthetic construct
  misc_feature 1..9876: note = derived and/or modified CDS sequence (opt4) from DENV-2__FJ898453__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagagacaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgtgtacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtggcccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17400 - RNA, 9876 nt, synthetic construct
  misc_feature 1..9876: note = derived and/or modified CDS sequence (opt4) from DENV-2__EU482445__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccctgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17401 - RNA, 9876 nt, synthetic construct
  misc_feature 1..9876: note = derived and/or modified CDS sequence (opt4) from DENV-2__EU482446__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17402 - RNA, 9876 nt, synthetic construct
  misc_feature 1..9876: note = derived and/or modified CDS sequence (opt4) from DENV-2__EU482448__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17403 - RNA, 9876 nt, synthetic construct
  misc_feature 1..9876: note = derived and/or modified CDS sequence (opt4) from DENV-2__EU482449__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaacaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgttctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17404 - RNA, 9876 nt, synthetic construct
  misc_feature 1..9876: note = derived and/or modified CDS sequence (opt4) from DENV-2__EU482450__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcgccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacgccgactacatgcccagcatgaagagattcagaagagaggaggaggaggccggcgtgctgtggtga

SEQ ID NO: 17405 - RNA, 9876 nt, synthetic construct
  misc_feature 1..9876: note = derived and/or modified CDS sequence (opt4) from DENV-2__EU569721__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccctgcccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17406 - RNA, 9876 nt, synthetic construct
  misc_feature 1..9876: note = derived and/or modified CDS sequence (opt4) from DENV-2__EU482451__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccggcgccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccaagaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaacgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17407 - RNA, 9876 nt, synthetic construct
  misc_feature 1..9876: note = derived and/or modified CDS sequence (opt4) from DENV-2__EU660413__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcttcgacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtgatcctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgagccccaccgccatcttcctgaccaccctgagcagaagcaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcggcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagaagcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17408 - RNA, 9876 nt, synthetic construct
  misc_feature 1..9876: note = derived and/or modified CDS sequence (opt4) from DENV-2__EU660414__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcaacagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaatcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcagccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17409 - RNA, 9876 nt, synthetic construct
  misc_feature 1..9876: note = derived and/or modified CDS sequence (opt4) from DENV-2__EU660415__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtgggccccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagactgggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagggcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgtgatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17410 - RNA, 9876 nt, synthetic construct
  misc_feature 1..9876: note = derived and/or modified CDS sequence (opt4) from DENV-2__EU687249__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggccagagaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcatgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcagagtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggagcgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17411 - RNA, 9876 nt, synthetic construct
  misc_feature 1..9876: note = derived and/or modified CDS sequence (opt4) from DENV-2__EU660416__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagagaagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcatgaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacaaggtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17412 - RNA, 9876 nt, synthetic construct
  misc_feature 1..9876: note = derived and/or modified CDS sequence (opt4) from DENV-2__EU660417__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagagaagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcagccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacaaggtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17413 - RNA, 9876 nt, synthetic construct
  misc_feature 1..9876: note = derived and/or modified CDS sequence (opt4) from DENV-2__EU677137__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgaccgtgaccgaggactgcggcagcagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccgtgaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccatgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17414 - RNA, 9876 nt, synthetic construct
  misc_feature 1..9876: note = derived and/or modified CDS sequence (opt4) from DENV-2__EU677138__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcagagccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17415 - RNA, 9876 nt, synthetic construct
  misc_feature 1..9876: note = derived and/or modified CDS sequence (opt4) from DENV-2__EU677149__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagagaagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacaaggtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17416 - RNA, 9876 nt, synthetic construct
  misc_feature 1..9876: note = derived and/or modified CDS sequence (opt4) from DENV-2__FJ024452__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcggccacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccggcaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaatcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcgccagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17417 - RNA, 9876 nt, synthetic construct
  misc_feature 1..9876: note = derived and/or modified CDS sequence (opt4) from DENV-2__FJ205877__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagagaagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactaccccgacagaagatggtgcttcgacggcatcaagaacaaccagatcctggaggagaacgtggaggtggagatctggcccaaggagggcgagagaaagaagctgaagcccagatggctggaccccagaatctacagcgagcccagagccctgaaggagttcaaggagttcccccccggcagaaagagcctgaccctgaacctgatcaccgagatgggcagactgcccaccttcatgacccagaagaccagagacgccctggacaacctggccggcctgcacaccgccgaggccggcggcagagccgacaaccacgccctgagcgagctggccgagaccctggagaccctgctgctgctgaccctgctggccaccggcaccggcggcatcttcctgttcctgatgagcggcagaggcatcggcaagatgaccctgggcatgtgctgcatcatcaccgccagcatcctgctgtgggacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtgggcgccaccatgcccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctgggccctggccaagatggacatcggcgtgcccctgctgggcatcggctgctacagccaggtgaaccccatcaccctgaccggcgccctgctgctgctgggcggccactacgccatcatcggccccggcctgcaggccaaggccaccagagaggcccagaagagagccgcccccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcgccagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggaccccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaaggccagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggccacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgcccagaatggccatcagcggcgacgactgcgtggtgaagcccctggacgccagattcgccaacgccctgaccgccctgaacgccatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacaaggtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17418 - RNA, 9876 nt, synthetic construct
  misc_feature 1..9876: note = derived and/or modified CDS sequence (opt4) from DENV-2__FJ024454__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggccccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgagaacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggcccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaccggcgtggtgagactgctgaccaagccctgggacgtgctgcccaccgtgacccagatggccatgaccgacaccacccccttcggccagcagagagtgttcaaggagaaggtggacaccagaacccaggaccccaaggaggccaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgcccgtgaccgaggaggtggccgtgcagaactggctggccagagtgggcagagagagactgagcagaatgcccatcagcggcgacgactgcgtggtgaagcccctggacgccagattccccaccgccctgacccccctgaacgacatgggcaagatcagaaaggacatccaccagtgggaccccagcaagggctggaacgactggacccaggtgcccttctgcagccaccacttccacgagctgatcatgaaggacggcagagtgctggtggtgccctgcagaaaccaggacgacctgatcgccagagccagaatcagccagggccccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17419 - RNA, 9876 nt, synthetic construct
  misc_feature 1..9876: note = derived and/or modified CDS sequence (opt4) from DENV-2__FJ205878__SS-prME
  source 1..9876: mol_type = other RNA
agcgccggcatgatcatcatgctgatccccaccgtgaccgccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacagagagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaccgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17420 - RNA, 9876 nt, synthetic construct
  misc_feature 1..9876: note = derived and/or modified CDS sequence (opt4) from DENV-2__FJ205879__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcaccaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaaccccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17421 - RNA, 9876 nt, synthetic construct
  misc_feature 1..9876: note = derived and/or modified CDS sequence (opt4) from DENV-2__FJ390385__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgccaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgggctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagaagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaccgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17422 - RNA, 9876 nt, synthetic construct
  misc_feature 1..9876: note = derived and/or modified CDS sequence (opt4) from DENV-2__FJ024458__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcagaagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatggactactggatcgagagcgccctgaacgacacctggaagatcgagaaggccagcttcatcgaggtgaagaactgccactgggccaagagccacaccctgtggagcaacggcgtgctggagagcgagatgatcatccccaagaacctggccggccccgtgagccagcacaactacagactgggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17423 - RNA, 9876 nt, synthetic construct
  misc_feature 1..9876: note = derived and/or modified CDS sequence (opt4) from DENV-2__FJ205880__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccagctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17424 - RNA, 9876 nt, synthetic construct
  misc_feature 1..9876: note = derived and/or modified CDS sequence (opt4) from DENV-2__FJ390387__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaaggtgcccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctggtgggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17425 - RNA, 9876 nt, synthetic construct
  misc_feature 1..9876: note = derived and/or modified CDS sequence (opt4) from DENV-2__FJ024461__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagactgggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagggcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17426 - RNA, 9876 nt, synthetic construct
  misc_feature 1..9876: note = derived and/or modified CDS sequence (opt4) from DENV-2__FJ373299__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcagactgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccggcggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17427 - RNA, 9876 nt, synthetic construct
  misc_feature 1..9876: note = derived and/or modified CDS sequence (opt4) from DENV-2__FJ410193__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcaccaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccgcccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17428 - RNA, 9876 nt, synthetic construct
  misc_feature 1..9876: note = derived and/or modified CDS sequence (opt4) from DENV-2__FJ410195__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatcgtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgctgcccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17429 - RNA, 9876 nt, synthetic construct
  misc_feature 1..9876: note = derived and/or modified CDS sequence (opt4) from DENV-2__FJ432726__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgccagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17430 - RNA, 9876 nt, synthetic construct
  misc_feature 1..9876: note = derived and/or modified CDS sequence (opt4) from DENV-2__JF730049__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgtggtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaagacctggggcaaggccaagatgttcagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgagaatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcatcgaggagtacaccgactacatgcccagcatgaagagattcagaagagaggaggaggaggccggcgtgctgtggtga

SEQ ID NO: 17431 - RNA, 9876 nt, synthetic construct
  misc_feature 1..9876: note = derived and/or modified CDS sequence (opt4) from DENV-2__FJ562098__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgccaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccatcgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatggtgatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17432 - RNA, 9876 nt, synthetic construct
  misc_feature 1..9876: note = derived and/or modified CDS sequence (opt4) from DENV-2__FJ859028__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaagaacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17433 - RNA, 9876 nt, synthetic construct
  misc_feature 1..9876: note = derived and/or modified CDS sequence (opt4) from DENV-2__FJ410200__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcaacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgagaacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccaccagacagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaagatgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17434 - RNA, 9876 nt, synthetic construct
  misc_feature 1..9876: note = derived and/or modified CDS sequence (opt4) from DENV-2__FJ410202__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggaggtgtggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacatcgactacatgcccagcatgaagagattcagaagagaggaggaggaggccggcgtgctgtggtga

SEQ ID NO: 17435 - RNA, 9876 nt, synthetic construct
  misc_feature 1..9876: note = derived and/or modified CDS sequence (opt4) from DENV-2__FJ410208__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcaacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccaccagacagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgatcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17436 - RNA, 9876 nt, synthetic construct
  misc_feature 1..9876: note = derived and/or modified CDS sequence (opt4) from DENV-2__FJ461305__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagagagccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17437 - RNA, 9876 nt, synthetic construct
  misc_feature 1..9876: note = derived and/or modified CDS sequence (opt4) from DENV-2__FJ410215__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccgccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17438 - RNA, 9876 nt, synthetic construct
  misc_feature 1..9876: note = derived and/or modified CDS sequence (opt4) from DENV-2__FJ461309__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17439 - RNA, 9876 nt, synthetic construct
  misc_feature 1..9876: note = derived and/or modified CDS sequence (opt4) from DENV-2__FJ461311__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcaacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccaccagacagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagccagctgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17440 - RNA, 9876 nt, synthetic construct
  misc_feature 1..9876: note = derived and/or modified CDS sequence (opt4) from DENV-2__FJ410217__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcatcgtgagctggaagaacaaggagctgaagtgcggcagcggcatcttcgtgaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcttcggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctggccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacgccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17441 - RNA, 9876 nt, synthetic construct
  misc_feature 1..9876: note = derived and/or modified CDS sequence (opt4) from DENV-2__FJ410219__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatcctgatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagattcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcatgaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgatcaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagtgaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17442 - RNA, 9876 nt, synthetic construct
  misc_feature 1..9876: note = derived and/or modified CDS sequence (opt4) from DENV-2__FJ461314__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccctgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17443 - RNA, 9876 nt, synthetic construct
  misc_feature 1..9876: note = derived and/or modified CDS sequence (opt4) from DENV-2__FJ410221__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccatcatggccgacgacatcggcatcggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagagcgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagtggagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacgtgggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17444 - RNA, 9876 nt, synthetic construct
  misc_feature 1..9876: note = derived and/or modified CDS sequence (opt4) from DENV-2__FJ547064__SS-prME
  source 1..9876: mol_type = other RNA
agcgccggcatgatcatcatgctgatccccaccgtgatggccttccacctgaccaccagaaacggcgagccccacatggtggtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacagagagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgtggcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacatccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaccgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga
